United States Patent 11,931,406 (FLAVIVIRUS VACCINE) - sequence listing, part 32

SEQ ID NO: 12818 - RNA, 9873 nt, Artificial Sequence
  derived and/or modified CDS sequence (opt2) from DENV-3__FJ562107__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12819 - RNA, 9873 nt, Artificial Sequence
  derived and/or modified CDS sequence (opt2) from DENV-3__FJ547071__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaagaccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucauccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12820 - RNA, 9873 nt, Artificial Sequence
  derived and/or modified CDS sequence (opt2) from DENV-3__FJ410176__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggcuccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12821 - RNA, 9873 nt, Artificial Sequence
  derived and/or modified CDS sequence (opt2) from DENV-3__FJ410177__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcaccggcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12822 - RNA, 9873 nt, Artificial Sequence
  derived and/or modified CDS sequence (opt2) from DENV-3__FJ547072__SS-prME
accucccucugccucaugaugauccuccccgccgcccucgccuuccaccucaccucccgcgacggcgagccccgcaugaucgucggcaagaacgagcgcggccgcucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12823 - RNA, 9873 nt, Artificial Sequence
  derived and/or modified CDS sequence (opt2) from DENV-3__FJ547073__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgcuacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12824 - RNA, 9873 nt, Artificial Sequence
  derived and/or modified CDS sequence (opt2) from DENV-3__FJ547074__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugaccuaccgccgccccaccaucgagaaggacgucguccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12825 - RNA, 9873 nt, Artificial Sequence
  derived and/or modified CDS sequence (opt2) from DENV-3__FJ547075__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgaguccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12826 - RNA, 9873 nt, Artificial Sequence
  derived and/or modified CDS sequence (opt2) from DENV-3__FJ547076__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccgucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12827 - RNA, 9873 nt, Artificial Sequence
  derived and/or modified CDS sequence (opt2) from DENV-3__FJ547077__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggaaccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12828 - RNA, 9873 nt, Artificial Sequence
  derived and/or modified CDS sequence (opt2) from DENV-3__FJ547078__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccuggaucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcacccccaaguccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12829 - RNA, 9873 nt, Artificial Sequence
  derived and/or modified CDS sequence (opt2) from DENV-3__FJ547079__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcacaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12830 - RNA, 9873 nt, Artificial Sequence
  derived and/or modified CDS sequence (opt2) from DENV-3__FJ547080__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccgcaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12831 - RNA, 9873 nt, Artificial Sequence
  derived and/or modified CDS sequence (opt2) from DENV-3__FJ547081__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucuccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacgccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucuccuccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacucccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12832 - RNA, 9873 nt, Artificial Sequence
  derived and/or modified CDS sequence (opt2) from DENV-3__FJ547082__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagauguggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12833 - RNA, 9873 nt, Artificial Sequence
  derived and/or modified CDS sequence (opt2) from DENV-3__FJ547083__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccaguccuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccuccgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12834 - RNA, 9873 nt, Artificial Sequence
  derived and/or modified CDS sequence (opt2) from DENV-3__FJ547084__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagcgcggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12835 - RNA, 9873 nt, Artificial Sequence
  derived and/or modified CDS sequence (opt2) from DENV-3__FJ478456__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucuccauccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12836 - RNA, 9873 nt, Artificial Sequence
  derived and/or modified CDS sequence (opt2) from DENV-3__FJ547085__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccaccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12837 - RNA, 9873 nt, Artificial Sequence
  derived and/or modified CDS sequence (opt2) from DENV-3__EU482595__SS-prME
accucccucugccucaugaugaugcuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacgucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagguccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcauccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucuccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccgcccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12838 - RNA, 9873 nt, Artificial Sequence
  derived and/or modified CDS sequence (opt2) from DENV-3__EU482596__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12839 - RNA, 9873 nt, Artificial Sequence
  derived and/or modified CDS sequence (opt2) from DENV-3__JQ922554__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgagcucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccucccaggccuccaccgccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccaagacccccaccuggaaccgcaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguaccgcaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauggccuucuccugcaucgccaucggcaucaucacccucuacgucggcgucgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaccggcguccucgagcagggcgagcgcacccucaccccccagcccauggagcucaaguacuccuggaagaccuggggcaaggccaagaucgucaccgccgagacccagaacuccuccuucaucaucgacggccccuccacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucuccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgccuccgccggcuccggcaaggucgacaacuucaccaugggcguccucugccucgccauccucuucgaggaggucaugcgcggcaaguuccgcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccgccacccuccgccuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccagugggccaagggcggcgagacccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcucgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcggcuccaacuacaaccucaucaucauggacgaggcccacuucaccgaccccgccuccaucgccgccaucggcuacaucuccacccgcgucggcaugggcgaggccgccgccaucuucaugaccgccaccccccccggcaccgucgacgccuucccccaguccaucccccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucuaccuccgccgcugccucaagcccgucauccucaccaacggccccgagcgcgucauccucgccggccccaugcccgucaccgucgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaacuggcgcccccgcuggcucgacgcccgcaccuacuccgacccccucgcccucaaggaguucaaggacuucgccgccggccgcaaguccaucgcccucgaccucgucaccgagaucggccgcguccccucccaccucgcccacaccguccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccacccccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucgccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccuggccccucugcgagguccucgcccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucuuccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccugggucaagaacaaccaguucugcaucaagguccucaaccccuacaugcccuccgucaucgagcaccucgagaaccuccagcgcaagcacggcggcauccucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaaggacucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggcccgcgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccacccccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcuccucggcaaggcccgcaucucccagggcgccggcuggucccuccgcgagaccgccugccucggcaaggccuacgcccagauguggacccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12840 - RNA, 9873 nt, Artificial Sequence
  derived and/or modified CDS sequence (opt2) from DENV-3__EU529683__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccaccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12841 - RNA, 9873 nt, Artificial Sequence
  derived and/or modified CDS sequence (opt2) from DENV-3__EU529684__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagaagcucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaccgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggacgagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12842 - RNA, 9873 nt, Artificial Sequence
  derived and/or modified CDS sequence (opt2) from DENV-3__FJ182015__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12843 - RNA, 9873 nt, Artificial Sequence
  derived and/or modified CDS sequence (opt2) from DENV-3__EU569688__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggccgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagcgcugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12844 - RNA, 9873 nt, Artificial Sequence
  derived and/or modified CDS sequence (opt2) from DENV-3__EU529686__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgagaacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacucccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12845 - RNA, 9873 nt, Artificial Sequence
  derived and/or modified CDS sequence (opt2) from DENV-3__EU529687__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12846 - RNA, 9873 nt, Artificial Sequence
  derived and/or modified CDS sequence (opt2) from DENV-3__KF955449__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12847 - RNA, 9873 nt, Artificial Sequence
  derived and/or modified CDS sequence (opt2) from DENV-3__FJ373303__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacgucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacgucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12848 - RNA, 9873 nt, Artificial Sequence
  derived and/or modified CDS sequence (opt2) from DENV-3__KF955451__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcgucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgucgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacgucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcuccgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12849 - RNA, 9873 nt, Artificial Sequence
  derived and/or modified CDS sequence (opt2) from DENV-3__KF955453__SS-prME
accucccucugccucaugaugauccuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugaucucccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12850 - RNA, 9873 nt, Artificial Sequence
  derived and/or modified CDS sequence (opt2) from DENV-3__FJ373304__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaaggucguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucauccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12851 - RNA, 9873 nt, Artificial Sequence
  derived and/or modified CDS sequence (opt2) from DENV-3__EU854291__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccaucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccgucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggcuccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12852 - RNA, 9873 nt, Artificial Sequence
  derived and/or modified CDS sequence (opt2) from DENV-3__KF955454__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgagggcgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuuccucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcgccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccacccccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12853 - RNA, 9873 nt, Artificial Sequence
  derived and/or modified CDS sequence (opt2) from DENV-3__EU854292__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcaucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccgcccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucugccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccacaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12854 - RNA, 9873 nt, Artificial Sequence
  derived and/or modified CDS sequence (opt2) from DENV-3__FJ639746__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12855 - RNA, 9873 nt, Artificial Sequence
  derived and/or modified CDS sequence (opt2) from DENV-3__FJ639750__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12856 - RNA, 9873 nt, Artificial Sequence
  derived and/or modified CDS sequence (opt2) from DENV-3__FJ639754__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcaacuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12857 - RNA, 9873 nt, Artificial Sequence
  derived and/or modified CDS sequence (opt2) from DENV-3__FJ639757__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacuccgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12858 - RNA, 9873 nt, Artificial Sequence
  derived and/or modified CDS sequence (opt2) from DENV-3__FJ639758__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggccgcugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12859 - RNA, 9873 nt, Artificial Sequence
  derived and/or modified CDS sequence (opt2) from DENV-3__FJ639759__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggauccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccuccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12860 - RNA, 9873 nt, Artificial Sequence
  derived and/or modified CDS sequence (opt2) from DENV-3__FJ639761__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccuccagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgucaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggccuccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12861 - RNA, 9873 nt, Artificial Sequence
  derived and/or modified CDS sequence (opt2) from DENV-3__FJ639762__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaagaucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcaucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12862 - RNA, 9873 nt, Artificial Sequence
  derived and/or modified CDS sequence (opt2) from DENV-3__FJ639763__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaacggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12863 - RNA, 9873 nt, Artificial Sequence
  derived and/or modified CDS sequence (opt2) from DENV-3__FJ639765__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucauccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12864 - RNA, 9873 nt, Artificial Sequence
  derived and/or modified CDS sequence (opt2) from DENV-3__FJ639766__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12865 - RNA, 9873 nt, Artificial Sequence
  derived and/or modified CDS sequence (opt2) from DENV-3__FJ639767__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaucuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12866 - RNA, 9873 nt, Artificial Sequence
  derived and/or modified CDS sequence (opt2) from DENV-3__FJ639768__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccauccccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuacaucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12867 - RNA, 9873 nt, Artificial Sequence
  derived and/or modified CDS sequence (opt2) from DENV-3__FJ639769__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12868 - RNA, 9873 nt, Artificial Sequence
  derived and/or modified CDS sequence (opt2) from DENV-3__FJ882577__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcaucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12869 - RNA, 9873 nt, Artificial Sequence
  derived and/or modified CDS sequence (opt2) from DENV-3__FJ850096__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggccuccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucaccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12870 - RNA, 9873 nt, Artificial Sequence
  derived and/or modified CDS sequence (opt2) from DENV-3__FJ882578__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcauccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12871 - RNA, 9873 nt, Artificial Sequence
  derived and/or modified CDS sequence (opt2) from DENV-3__FJ639770__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucacccuccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12872 - RNA, 9873 nt, Artificial Sequence
  derived and/or modified CDS sequence (opt2) from DENV-3__FJ639771__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccuccgcgagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggccuccucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12873 - RNA, 9873 nt, Artificial Sequence
  derived and/or modified CDS sequence (opt2) from DENV-3__FJ639772__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggauccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccuccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12874 - RNA, 9873 nt, Artificial Sequence
  derived and/or modified CDS sequence (opt2) from DENV-3__FJ639774__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcaccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12875 - RNA, 9873 nt, Artificial Sequence
  derived and/or modified CDS sequence (opt2) from DENV-3__FJ639775__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgccaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12876 - RNA, 9873 nt, Artificial Sequence
  derived and/or modified CDS sequence (opt2) from DENV-3__FJ639777__SS-prME
accucccucugccucaugaugacccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucgccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaagcucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccauccccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuacaucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucacccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcuccccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccaccgccucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12877 - RNA, 9873 nt, Artificial Sequence
  derived and/or modified CDS sequence (opt2) from DENV-3__FJ639778__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggccgcaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacauggucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccucaagaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccuccgccgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12878 - RNA, 9873 nt, Artificial Sequence
  derived and/or modified CDS sequence (opt2) from DENV-3__FJ639779__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagcgcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacuucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccgcccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccgccaugaagcgcuuccgcaaggaggaggaguccgagggcgccaucugguga

SEQ ID NO: 12879 - RNA, 9873 nt, Artificial Sequence
  derived and/or modified CDS sequence (opt2) from DENV-3__FJ639780__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcaccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcauccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12880 - RNA, 9873 nt, Artificial Sequence
  derived and/or modified CDS sequence (opt2) from DENV-3__FJ639781__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccaguacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaucuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucgcccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12881 - RNA, 9873 nt, Artificial Sequence
  derived and/or modified CDS sequence (opt2) from DENV-3__FJ639782__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12882 - RNA, 9873 nt, Artificial Sequence
  derived and/or modified CDS sequence (opt2) from DENV-3__FJ639785__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12883 - RNA, 9873 nt, Artificial Sequence
  derived and/or modified CDS sequence (opt2) from DENV-3__FJ639786__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccugggccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaagaccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacaucuccaccgccauccagcagguccgcucccucaucggcaacgaggaguuccucgacuacaugcccuccaugaagcgcuuccgcaaggaggaggaguccgagggcgccaucugguga

SEQ ID NO: 12884 - RNA, 9873 nt, Artificial Sequence
  derived and/or modified CDS sequence (opt2) from DENV-3__FJ639787__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggcucuccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12885 - RNA, 9873 nt, Artificial Sequence
  derived and/or modified CDS sequence (opt2) from DENV-3__FJ639790__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccgccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12886 - RNA, 9873 nt, Artificial Sequence
  derived and/or modified CDS sequence (opt2) from DENV-3__FJ639791__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccgucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucaucuccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcuccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12887 - RNA, 9873 nt, Artificial Sequence
  derived and/or modified CDS sequence (opt2) from DENV-3__FJ639792__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagcgcgaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12888 - RNA, 9873 nt, Artificial Sequence
  derived and/or modified CDS sequence (opt2) from DENV-3__FJ639793__SS-prME
accucccucugccucaugaugauccuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaccuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccgucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12889 - RNA, 9873 nt, Artificial Sequence
  derived and/or modified CDS sequence (opt2) from DENV-3__FJ639795__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcaucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccuccucaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12890 - RNA, 9873 nt, Artificial Sequence
  derived and/or modified CDS sequence (opt2) from DENV-3__FJ639798__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccgucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacaucaacgccgagcccgagacccccaacauggacgucaucggcgagcgcaucaagcgcaucaaggaggagcacaacuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12891 - RNA, 9873 nt, Artificial Sequence
  derived and/or modified CDS sequence (opt2) from DENV-3__FJ639799__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcaugucccgcgagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12892 - RNA, 9873 nt, Artificial Sequence
  derived and/or modified CDS sequence (opt2) from DENV-3__FJ639800__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagguccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccuccgcaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcuccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12893 - RNA, 9873 nt, Artificial Sequence
  derived and/or modified CDS sequence (opt2) from DENV-3__FJ639801__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccugcaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagcgccucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12894 - RNA, 9873 nt, Artificial Sequence
  derived and/or modified CDS sequence (opt2) from DENV-3__KF955471__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcuccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12895 - RNA, 9873 nt, Artificial Sequence
  derived and/or modified CDS sequence (opt2) from DENV-3__FJ639803__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcuccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12896 - RNA, 9873 nt, Artificial Sequence
  derived and/or modified CDS sequence (opt2) from DENV-3__FJ639804__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagucccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcaucgagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaucccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12897 - RNA, 9873 nt, Artificial Sequence
  derived and/or modified CDS sequence (opt2) from DENV-3__FJ639805__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccuccgccgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggccucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12898 - RNA, 9873 nt, Artificial Sequence
  derived and/or modified CDS sequence (opt2) from DENV-3__FJ639807__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagcgccucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12899 - RNA, 9873 nt, Artificial Sequence
  derived and/or modified CDS sequence (opt2) from DENV-3__FJ639810__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucugccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucaugcccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccucuacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12900 - RNA, 9873 nt, Artificial Sequence
  derived and/or modified CDS sequence (opt2) from DENV-3__FJ639816__SS-prME
accucccucugccucaugaugauccuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacgagcagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccgucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12901 - RNA, 9873 nt, Artificial Sequence
  derived and/or modified CDS sequence (opt2) from DENV-3__FJ639817__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacucccgcaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcaugucccgcgagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12902 - RNA, 9873 nt, Artificial Sequence
  derived and/or modified CDS sequence (opt2) from DENV-3__FJ639825__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgacuacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcagugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcacaagcagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12903 - RNA, 9873 nt, Artificial Sequence
  derived and/or modified CDS sequence (opt2) from DENV-3__FJ639826__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccaccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucaccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12904 - RNA, 9873 nt, Artificial Sequence
  derived and/or modified CDS sequence (opt2) from DENV-3__FJ810416__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucaugaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12905 - RNA, 9873 nt, Artificial Sequence
  derived and/or modified CDS sequence (opt2) from DENV-3__GQ252678__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacaucuccaccgccauccagcagguccgcucccucaucggcaacgaggaguuccucgacuacaugcccuccaugaagcgcuuccgcaaggaggaggaguccgagggcgccaucugguga

SEQ ID NO: 12906 - RNA, 9873 nt, Artificial Sequence
  derived and/or modified CDS sequence (opt2) from DENV-3__FJ850098__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggaccccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucacccuccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12907 - RNA, 9873 nt, Artificial Sequence
  derived and/or modified CDS sequence (opt2) from DENV-3__KF955479__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaucgucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12908 - RNA, 9873 nt, Artificial Sequence
  derived and/or modified CDS sequence (opt2) from DENV-3__FJ850109__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaccggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacucccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccaccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12909 - RNA, 9873 nt, Artificial Sequence
  derived and/or modified CDS sequence (opt2) from DENV-3__GQ868586__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgacuacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcagugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgaggucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgagcgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcacaagcagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucgccaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12910 - RNA, 9873 nt, Artificial Sequence
  derived and/or modified CDS sequence (opt2) from DENV-3__FJ850110__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccaccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12911 - RNA, 9873 nt, Artificial Sequence
  derived and/or modified CDS sequence (opt2) from DENV-3__FJ850111__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacucccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccaacaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccaccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12912 - RNA, 9873 nt, Artificial Sequence
  derived and/or modified CDS sequence (opt2) from DENV-3__KF955486__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12913 - RNA, 9873 nt, Artificial Sequence
  derived and/or modified CDS sequence (opt2) from DENV-3__FJ898468__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12914 - RNA, 9873 nt, Artificial Sequence
  derived and/or modified CDS sequence (opt2) from DENV-3__FJ898469__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggccuccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12915 - RNA, 9873 nt, Artificial Sequence
  derived and/or modified CDS sequence (opt2) from DENV-3__FJ898470__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccgccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12916 - RNA, 9873 nt, Artificial Sequence
  derived and/or modified CDS sequence (opt2) from DENV-3__FJ898471__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12917 - RNA, 9873 nt, Artificial Sequence
  derived and/or modified CDS sequence (opt2) from DENV-3__FJ898472__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12918 - RNA, 9873 nt, Artificial Sequence
  derived and/or modified CDS sequence (opt2) from DENV-3__FJ898474__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucaugaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccaucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagggccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaucggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaucaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgaguccccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12919 - RNA, 9873 nt, Artificial Sequence
  derived and/or modified CDS sequence (opt2) from DENV-3__EU529688__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12920 - RNA, 9873 nt, Artificial Sequence
  derived and/or modified CDS sequence (opt2) from DENV-3__EU482613__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12921 - RNA, 9873 nt, Artificial Sequence
  derived and/or modified CDS sequence (opt2) from DENV-3__EU529690__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12922 - RNA, 9873 nt, Artificial Sequence
  derived and/or modified CDS sequence (opt2) from DENV-3__EU529691__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccgucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12923 - RNA, 9873 nt, Artificial Sequence
  derived and/or modified CDS sequence (opt2) from DENV-3__EU569689__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaaggccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgaccucgcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12924 - RNA, 9873 nt, Artificial Sequence
  derived and/or modified CDS sequence (opt2) from DENV-3__EU482614__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12925 - RNA, 9873 nt, Artificial Sequence
  derived and/or modified CDS sequence (opt2) from DENV-3__EU569690__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggucccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacgagcagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaucccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12926 - RNA, 9873 nt, Artificial Sequence
  derived and/or modified CDS sequence (opt2) from DENV-3__EU569691__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucacccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuaccgcaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12927 - RNA, 9873 nt, Artificial Sequence
  derived and/or modified CDS sequence (opt2) from DENV-3__EU482452__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucgacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccucaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcgucuccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12928 - RNA, 9873 nt, Artificial Sequence
  derived and/or modified CDS sequence (opt2) from DENV-3__EU482453__SS-prME
accucccucugccucaucaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaccaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagcucgagggcgccaucugguga

SEQ ID NO: 12929 - RNA, 9873 nt, Artificial Sequence
  derived and/or modified CDS sequence (opt2) from DENV-3__EU482454__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgccaagggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggucgaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagcgcgagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaaguccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaugggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagcgcaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccgcccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12930 - RNA, 9873 nt, Artificial Sequence
  derived and/or modified CDS sequence (opt2) from DENV-3__EU482455__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucgucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgccuucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaucggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12931 - RNA, 9873 nt, Artificial Sequence
  derived and/or modified CDS sequence (opt2) from DENV-3__EU482456__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaccgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12932 - RNA, 9873 nt, Artificial Sequence
  derived and/or modified CDS sequence (opt2) from DENV-3__EU482457__SS-prME
accuccuucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcauccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggaccgccucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucauggucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucggccccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacaacgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12933 - RNA, 9873 nt, Artificial Sequence
  derived and/or modified CDS sequence (opt2) from DENV-3__EU482458__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucaccaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcaugcgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccaucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12934 - RNA, 9873 nt, Artificial Sequence
  derived and/or modified CDS sequence (opt2) from DENV-3__EU482459__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12935 - RNA, 9873 nt, Artificial Sequence
  derived and/or modified CDS sequence (opt2) from DENV-3__EU482460__SS-prME
accucccucugccucaugaugaugcuccccgccaccuucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcaccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguaccgcuuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcgcccucgccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaugggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgaccccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12936 - RNA, 9873 nt, Artificial Sequence
  derived and/or modified CDS sequence (opt2) from DENV-3__EU482461__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12937 - RNA, 9873 nt, Artificial Sequence
  derived and/or modified CDS sequence (opt2) from DENV-3__EU482462__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggcccgcaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggaccucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggaaggacauggcccacaccuucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucguccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaucucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12938 - RNA, 9873 nt, Artificial Sequence
  derived and/or modified CDS sequence (opt2) from DENV-3__EU660407__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgagaacgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagcgcgucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12939 - RNA, 9873 nt, Artificial Sequence
  derived and/or modified CDS sequence (opt2) from DENV-3__EU660409__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccgccucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgacacccagggcgccaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcgcccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccauggccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggucgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaccgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12940 - RNA, 9873 nt, Artificial Sequence
  derived and/or modified CDS sequence (opt2) from DENV-3__EU660410__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggcccgcaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacaccuucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucguccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgccccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaucucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12941 - RNA, 9873 nt, Artificial Sequence
  derived and/or modified CDS sequence (opt2) from DENV-3__EU660411__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12942 - RNA, 9873 nt, Artificial Sequence
  derived and/or modified CDS sequence (opt2) from DENV-3__FJ432722__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgucaucugguga

SEQ ID NO: 12943 - RNA, 9873 nt, Artificial Sequence
  derived and/or modified CDS sequence (opt2) from DENV-3__FJ432728__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgaggacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12944 - RNA, 9873 nt, Artificial Sequence
  derived and/or modified CDS sequence (opt2) from DENV-3__FJ432731__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccagacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccaugaccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12945 - RNA, 9873 nt, Artificial Sequence
  derived and/or modified CDS sequence (opt2) from DENV-3__FJ562097__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccgccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12946 - RNA, 9873 nt, Artificial Sequence
  derived and/or modified CDS sequence (opt2) from DENV-3__FJ432741__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucgccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagguccacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacauggucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggaggucuucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcaagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12947 - RNA, 9873 nt, Artificial Sequence
  derived and/or modified CDS sequence (opt2) from DENV-3__FJ562099__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12948 - RNA, 9873 nt, Artificial Sequence
  derived and/or modified CDS sequence (opt2) from DENV-3__KF955457__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgccaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuucuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgaggacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgaccgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12949 - RNA, 9873 nt, Artificial Sequence
  derived and/or modified CDS sequence (opt2) from DENV-3__FJ562100__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaccgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12950 - RNA, 9873 nt, Artificial Sequence
  derived and/or modified CDS sequence (opt2) from DENV-3__FJ547062__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucuccaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12951 - RNA, 9873 nt, Artificial Sequence
  derived and/or modified CDS sequence (opt2) from DENV-3__FJ461322__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgaggucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacauccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12952 - RNA, 9873 nt, Artificial Sequence
  derived and/or modified CDS sequence (opt2) from DENV-3__KF955458__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucaacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucaugaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12953 - RNA, 9873 nt, Artificial Sequence
  derived and/or modified CDS sequence (opt2) from DENV-3__FJ562102__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacaccuucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12954 - RNA, 9873 nt, Artificial Sequence
  derived and/or modified CDS sequence (opt2) from DENV-3__FJ410229__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12955 - RNA, 9873 nt, Artificial Sequence
  derived and/or modified CDS sequence (opt2) from DENV-3__FJ461326__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucuccaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggcccgcaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgcaagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12956 - RNA, 9873 nt, Artificial Sequence
  derived and/or modified CDS sequence (opt2) from DENV-3__FJ461329__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgaggacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12957 - RNA, 9873 nt, Artificial Sequence
  derived and/or modified CDS sequence (opt2) from DENV-3__KF955459__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccgccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12958 - RNA, 9873 nt, Artificial Sequence
  derived and/or modified CDS sequence (opt2) from DENV-3__FJ547066__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgagauggagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgagggcuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12959 - RNA, 9873 nt, Artificial Sequence
  derived and/or modified CDS sequence (opt2) from DENV-3__KF955460__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcaacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagaaggacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacauccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12960 - RNA, 9873 nt, Artificial Sequence
  derived and/or modified CDS sequence (opt2) from DENV-3__FJ461334__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucauccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12961 - RNA, 9873 nt, Artificial Sequence
  derived and/or modified CDS sequence (opt2) from DENV-3__FJ461337__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccaugggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgaggacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccgccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12962 - RNA, 9873 nt, Artificial Sequence
  derived and/or modified CDS sequence (opt2) from DENV-3__FJ461338__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucgucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12963 - RNA, 9873 nt, Artificial Sequence
  derived and/or modified CDS sequence (opt2) from DENV-3__FJ562103__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuaccgcugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcaacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagaaggacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacauccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12964 - RNA, 9873 nt, Artificial Sequence
  derived and/or modified CDS sequence (opt2) from DENV-3__FJ898456__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccaucuucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccucccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaaguccuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucaacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgagcgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccgccucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12965 - RNA, 9873 nt, Artificial Sequence
  derived and/or modified CDS sequence (opt2) from DENV-3__JN697379__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccucccaggccuccaccgccgaggucauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucaagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguaccgcaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgucgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaccggcguccucgagcagggcaagcgcacccucaccccccagcccauggagcucaaguacuccuggaagaccuggggcaaggccaagaucgucaccgccgagacccagaacuccuccuucaucaucgacggccccuccacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucuccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgucuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccgccacccuccgccuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucgccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgagguccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccacccccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggacccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12966 - RNA, 9873 nt, Artificial Sequence
  derived and/or modified CDS sequence (opt2) from DENV-3__JQ045687__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucgucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaccauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12967 - RNA, 9873 nt, Artificial Sequence
  derived and/or modified CDS sequence (opt2) from DENV-3__JQ045689__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaguucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucacccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacauccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12968 - RNA, 9873 nt, Artificial Sequence
  derived and/or modified CDS sequence (opt2) from DENV-3__JQ045691__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacaucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaucuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagaagcgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccuccucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccuccuccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcgccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacucccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12969 - RNA, 9873 nt, Artificial Sequence
  derived and/or modified CDS sequence (opt2) from DENV-3__JQ045692__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaucuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgaggcccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagaccuuccuccuccucggccucaugauccuccucaccggcggcgccaugcucuuccuccucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggcaaggacgucuucuaccucccccccgagaagugcgacacccuccucugcgacaucggcgaguccucccccuccuccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcgccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12970 - RNA, 9873 nt, Artificial Sequence
  derived and/or modified CDS sequence (opt2) from DENV-3__JQ045694__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucauguccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcccccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaaccucgucaagcucauguccggccgcgacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccgagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12971 - RNA, 9873 nt, Artificial Sequence
  derived and/or modified CDS sequence (opt2) from DENV-3__GU363549__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacgagcagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccaccauccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugcgccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccacccacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagaugaaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacaucuccaccgccauccagcagguccgcucccucaucggcaacgaggaguuccucgacuacaugcccuccaugaagcgcuuccgcaaggaggaggaguccgagggcgccaucugguga

SEQ ID NO: 12972 - RNA, 9873 nt, Artificial Sequence
  derived and/or modified CDS sequence (opt2) from DENV-3__KJ622197__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccaacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12973 - RNA, 9873 nt, Artificial Sequence
  derived and/or modified CDS sequence (opt2) from DENV-3__KJ622198__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccaacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgagucccuccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12974 - RNA, 9873 nt, Artificial Sequence
  derived and/or modified CDS sequence (opt2) from DENV-3__KJ622191__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgaggucauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaugggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12975 - RNA, 9873 nt, Artificial Sequence
  derived and/or modified CDS sequence (opt2) from DENV-3__KJ622192__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12976 - RNA, 9873 nt, Artificial Sequence
  derived and/or modified CDS sequence (opt2) from DENV-3__KJ622193__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcagggcgucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12977 - RNA, 9873 nt, Artificial Sequence
  derived and/or modified CDS sequence (opt2) from DENV-3__KJ622194__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacuccggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacgccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12978 - RNA, 9873 nt, Artificial Sequence
  derived and/or modified CDS sequence (opt2) from DENV-3__KJ622195__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucgaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccaacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12979 - RNA, 9873 nt, Artificial Sequence
  derived and/or modified CDS sequence (opt2) from DENV-3__KJ622196__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccaacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccacauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12980 - RNA, 9873 nt, Artificial Sequence
  derived and/or modified CDS sequence (opt2) from DENV-3__KJ830751__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccugggccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgaguccugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuacgaggaggucaugcgcggcaaguucggcaagaagcacaugaucgccggcgucuucuucaccuucguccuccuccucuccggccagaucaccuggcgcaacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgacgacaucgagcagauggccaacggcaucgcccucggccucauggcccucaagcucaucacccaguucgagaccuaccagcucuggaccgcccucgucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaucgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcauccuccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgaggucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucguccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucauccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucaccaaggccgaccucgagaacucccaccuccccgagaagaagaucacccaguggcucgagaccaagggcgucgagcgccucaagcgcauggccaucuccggcgacgacugcgucgucaagcccaucgacgaccgcuucgccaacgcccucgucgcccucaacgacaugggcaagguccgcaaggacaucccccaguggcagcccucccgcggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggagaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12981 - RNA, 9873 nt, Artificial Sequence
  derived and/or modified CDS sequence (opt2) from DENV-3__KC762681__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggaccucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccauguucacccucaccgucgccuggcgcaccgccacccucauccucgccggcaucucccuccuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgcccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaagaccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12982 - RNA, 9873 nt, Artificial Sequence
  derived and/or modified CDS sequence (opt2) from DENV-3__KC762684__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucuccaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagaugcagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccaucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagcgcgaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucgucacccaguucgagaccuaccagcucuggaccgcccucgucucccucaugugcuccaacaccaucuucacccucaccgucgccuggcgcaccgccacccucauccucgccggcaucucccuccucccccucugccaguccuccggcaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccuccgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgucaugcucuuccucaucuccggcaagggcgucggcaagaccuccaucggccucaucugcgucgucgccuccuccuccaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12983 - RNA, 9873 nt, Artificial Sequence
  derived and/or modified CDS sequence (opt2) from DENV-3__KC762686__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccaccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgcccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggagcccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12984 - RNA, 9873 nt, Artificial Sequence
  derived and/or modified CDS sequence (opt2) from DENV-3__KC762685__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcaccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgcccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggagcccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12985 - RNA, 9873 nt, Artificial Sequence
  derived and/or modified CDS sequence (opt2) from DENV-3__KC762687__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucgucaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccucuuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccguccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccacaagacccgcuccgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12986 - RNA, 9873 nt, Artificial Sequence
  derived and/or modified CDS sequence (opt2) from DENV-3__KC762688__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacacccucuucacccucaccgucgccuggcgcaccgccacccucauccucgccggcaucucccuccuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgcccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggaguuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagaagggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggaucgaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12987 - RNA, 9873 nt, Artificial Sequence
  derived and/or modified CDS sequence (opt2) from DENV-3__KC762689__SS-prME
accucccucugccucaugaugaugauccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgaguccugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucgucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgaccucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccguccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaaggucgaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12988 - RNA, 9873 nt, Artificial Sequence
  derived and/or modified CDS sequence (opt2) from DENV-3__KC762690__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccgucaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgcccacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggccauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuucuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggagcccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccucgagaaggagaucacccaguggcucgagaccaagggcgucgagcgccucaagcgcauggccaucuccggcgacgacugcgucgucaagcccaucgacgaccgcuucgccgacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucgccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12989 - RNA, 9873 nt, Artificial Sequence
  derived and/or modified CDS sequence (opt2) from DENV-3__KC762691__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaaggacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacaccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacuccccccgccgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcgcccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccucuuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcaucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12990 - RNA, 9873 nt, Artificial Sequence
  derived and/or modified CDS sequence (opt2) from DENV-3__KC762692__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgucggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugguccucaagcucaucacccaguucgagaccuaccagcucuggaccgcccucgucucccucaccugcuccaacaccaucuucacccucaccgucgccuggcgcaccgccacccucauccucgccggcaccucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaucaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccaccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaagaucauggagaucaccgccggcuggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcagggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaaccucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgagaacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12991 - RNA, 9873 nt, Artificial Sequence
  derived and/or modified CDS sequence (opt2) from DENV-3__JQ920481__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12992 - RNA, 9873 nt, Artificial Sequence
  derived and/or modified CDS sequence (opt2) from DENV-3__JQ920483__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcagaaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagcgcaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12993 - RNA, 9873 nt, Artificial Sequence
  derived and/or modified CDS sequence (opt2) from DENV-3__JQ920482__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12994 - RNA, 9873 nt, Artificial Sequence
  derived and/or modified CDS sequence (opt2) from DENV-3__JQ920484__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12995 - RNA, 9873 nt, Artificial Sequence
  derived and/or modified CDS sequence (opt2) from DENV-3__JQ920486__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgucgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaucgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12996 - RNA, 9873 nt, Artificial Sequence
  derived and/or modified CDS sequence (opt2) from DENV-3__JQ920485__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagaagcacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccauccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaucgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacaugaacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggagcccgagggcgccaucugguga

SEQ ID NO: 12997 - RNA, 9873 nt, Artificial Sequence
  derived and/or modified CDS sequence (opt2) from DENV-3__FJ644564__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucgagaaccucgagcucgacuucaccuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcauccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucauguccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccaguggcucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcucccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12998 - RNA, 9873 nt, Artificial Sequence
  derived and/or modified CDS sequence (opt2) from DENV-3__HQ235027__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaucgagauccagaacuccggcggcaccuccaucuucgccggccaccucaagugccgccucaagauggacaagcucgagcucaagggcauguccuacgccaugugcaccaagaccuucguccucaagaaggaggucuccgagacccagcacggcaccauccucaucaaggucgaguacaagggcgaggacgcccccugcaagauccccuucuccaccgaggacggccagggcaaggccuacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaucuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucgucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccgcuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12999 - RNA, 9873 nt, Artificial Sequence
  derived and/or modified CDS sequence (opt2) from DENV-3__JQ920476__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggaguccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13000 - RNA, 9873 nt, Artificial Sequence
  derived and/or modified CDS sequence (opt2) from DENV-3__JQ920477__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuccaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13001 - RNA, 9873 nt, Artificial Sequence
  derived and/or modified CDS sequence (opt2) from DENV-3__JQ920478__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccucccgcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggaccucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13002 - RNA, 9873 nt, Artificial Sequence
  derived and/or modified CDS sequence (opt2) from DENV-3__JQ920480__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgacuacggcacccucggccucgagugcuccccccgcaccggccucgacuucaacgagaugauccuccucaccaugaagaacaaggccuggaugguccaccgccagugguuccucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacgaguccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucauguucguccuccuccucuccggccagaucaccuggcgcgacaugguccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13003 - RNA, 9873 nt, Artificial Sequence
  derived and/or modified CDS sequence (opt2) from DENV-3__JQ920479__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguuccucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacgaguccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucauguucguccuccuccucuccggccagaucaccuggcgcgacaugguccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacuccgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13004 - RNA, 9873 nt, Artificial Sequence
  derived and/or modified CDS sequence (opt2) from DENV-3__KU216208__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccuggaucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacgccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgagaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauggccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13005 - RNA, 9873 nt, Artificial Sequence
  derived and/or modified CDS sequence (opt2) from DENV-3__GU370053__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccugggccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgaguccugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuacgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgaggucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucguccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucauccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucaccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccucccgcggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggagaaccccuggauggaggacaagacccccgucaccaccugggagaacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13006 - RNA, 9873 nt, Artificial Sequence
  derived and/or modified CDS sequence (opt2) from DENV-3__JQ411814__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcaucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgacgucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccauccucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucaugggcaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgacaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13007 - RNA, 9873 nt, Artificial Sequence
  derived and/or modified CDS sequence (opt2) from DENV-3__KM190937__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgccaucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagaugcagggcgucaccgccgagaucaccccccaggccuccaccgccgaggucauccuccccgaguacggcacccucggccucgagugcuccccccgcaccggccucgacuucaacgagaugaucucccucaccaugaagaacaaggccuggaugguccaccgccagugguucuucgaccucccccuccccuggaccuccggcgccaccgccgagacccccaccuggaaccgcaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucuccuccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaugaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaccggcguccucgagcagggcaagcgcacccucaccccccagcccauggagcucaaguacuccuggaagaccuggggcaaggccaagaucgucaccgccgagacccagaacuccuccuucaucaucgacggccccuccacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucuccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgccuccgccggcuccggcaaggucgacaacuucaccaugggcguccucugccucgccauccucuucgaggaggucaugcgcggcaaguucggcaagauccacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccgccacccuccgccuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcgcccagccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucauggucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucgccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgagguccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccacccccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13008 - RNA, 9873 nt, Artificial Sequence
  derived and/or modified CDS sequence (opt2) from DENV-3__JQ920487__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13009 - RNA, 9873 nt, Artificial Sequence
  derived and/or modified CDS sequence (opt2) from DENV-3__JQ920488__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacgaguccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucggcgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13010 - RNA, 9873 nt, Artificial Sequence
  derived and/or modified CDS sequence (opt2) from DENV-3__JQ920489__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggacccgcgagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaucgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacaugaacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13011 - RNA, 9873 nt, Artificial Sequence
  derived and/or modified CDS sequence (opt2) from DENV-3__KF824902__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcgcccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagacccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgagggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucguccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13012 - RNA, 9873 nt, Artificial Sequence
  derived and/or modified CDS sequence (opt2) from DENV-3__KF824903__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaccaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucggcggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcgcccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccgucgccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggccgcaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccaggccaacgccgagcccgagggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgagugcaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgccgcgaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaccgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggaguccgcccgcgccgccgucgaggacgaggaguucuggaagcucgucggccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13013 - RNA, 9873 nt, Artificial Sequence
  derived and/or modified CDS sequence (opt2) from DENV-3__JF504679__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgucaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccgucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagcgcgaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccaccauccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagaugaaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13014 - RNA, 9873 nt, Artificial Sequence
  derived and/or modified CDS sequence (opt2) from DENV-3__KC425219__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaaccccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13015 - RNA, 9873 nt, Artificial Sequence
  derived and/or modified CDS sequence (opt2) from DENV-3__AY858037__SS-prME
accucccucugccucaugaugaugcuccccgucacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgaccgcgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccucuuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13016 - RNA, 9873 nt, Artificial Sequence
  derived and/or modified CDS sequence (opt2) from DENV-3__KJ737429__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13017 - RNA, 9873 nt, Artificial Sequence
  derived and/or modified CDS sequence (opt2) from DENV-3__DQ863638__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucauccucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggcccccacacccccgagugcccccgcgccucccgcgccuggaacgucugggaggucgaggacuacggcuucggcgucuucaccaccaacaucuggcucaagcuccgcgaggaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgccuccgccggcuccggcaaggucgacaacuucaccaugggcuuccucugccucgccauccucuucgaggaggucaugcgcggcaaguucggcaagaagcacaugaucgccggcgucuuccucaccuuccuccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaacuuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuuccgcggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgccacccacuacgccaucaucggccccggccuccaggccaaggccacccgcgaggcccagaagcgcaccgccgccggcaucaccaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccgccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuucuucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccgcggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuucaagaaggaggaggaguccgagggcgccaucugguga

SEQ ID NO: 13018 - RNA, 9873 nt, Artificial Sequence
  derived and/or modified CDS sequence (opt2) from DENV-3__KJ737430__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13019 - RNA, 9873 nt, Artificial Sequence
  derived and/or modified CDS sequence (opt2) from DENV-3__AY858040__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagaagcagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccucaugcccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgccuacuggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccguccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccccaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggagcccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgaggacguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13020 - RNA, 9873 nt, Artificial Sequence
  derived and/or modified CDS sequence (opt2) from DENV-3__AY858041__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggccaggcccacaacggccgccucaucaccgccaaccccgucgucaccaagaaggaggagcccgucaacaucgaggccgagucccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgacgacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggaagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucuccuccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcagggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13021 - RNA, 9873 nt, Artificial Sequence
  derived and/or modified CDS sequence (opt2) from DENV-3__KC261634__SS-prME
accuccaucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaaccgccccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucauccgcgucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagauggcccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcguccucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacgcccccaagaagcgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgccgucuccuccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagcgccucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccauggagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccaccgccucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccgccucgccuccgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgaggacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13022 - RNA, 9873 nt, Artificial Sequence
  derived and/or modified CDS sequence (opt2) from DENV-3__JN662391__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacgagcagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucaugcuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccaccauccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccacccacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagaugaaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacaucuccaccgccauccagcagguccgcucccucaucggcaacgaggaguuccucgacuacaugcccuccaugaagcgcuuccgcaaggaggaggaguccgagggcgccaucugguga

SEQ ID NO: 13023 - RNA, 9873 nt, Artificial Sequence
  derived and/or modified CDS sequence (opt2) from DENV-3__AY858043__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggccgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugccgccacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaagguccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaaggucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcgcaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagaccuuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcagggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucauccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccucccgcggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13024 - RNA, 9873 nt, Artificial Sequence
  derived and/or modified CDS sequence (opt2) from DENV-3__AY858044__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccaucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccggcuggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcagggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13025 - RNA, 9873 nt, Artificial Sequence
  derived and/or modified CDS sequence (opt2) from DENV-3__AY858045__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccaucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgccaucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccgcacccucaucaugaucggcuccaacgccuccgaccgcaugggcaugggcgucaccuaccucgcccucaucgccaccuucgagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagcgccucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccggcuggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcagggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13026 - RNA, 9873 nt, Artificial Sequence
  derived and/or modified CDS sequence (opt2) from DENV-3__AY858046__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccaucaccuacaagugcccccucaucaccgaggucgagcccgaggacaucgacugcuggugcaaccucaccuccaccugggucaccuacggcaccugcaaccaggucggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucauguucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggcaugcucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccuccgccgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggccauggagaucaccgccggcuggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcagggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggagguccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13027 - RNA, 9873 nt, Artificial Sequence
  derived and/or modified CDS sequence (opt2) from DENV-3__AY858047__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacucccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccucccccucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcgcacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgucaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgccucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaucgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13028 - RNA, 9873 nt, Artificial Sequence
  derived and/or modified CDS sequence (opt2) from DENV-3__HQ332170__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgacuacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcagugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcuccauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcacaagcagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13029 - RNA, 9873 nt, Artificial Sequence
  derived and/or modified CDS sequence (opt2) from DENV-3__AY858038__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacauccgccucaccgucgucgucggcgacaccaucggcguccuccagcagggcaagcgcacccuccccccccagcccauggagcucaaguacuccuggaagaccuggggcaaggccaagaucgucaccgccaagacccagaacuccuccuucaucaucgacggccccaacacccccgaguggcccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucgucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagcgcaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13030 - RNA, 9873 nt, Artificial Sequence
  derived and/or modified CDS sequence (opt2) from DENV-3__AY858039__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaucuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcgucccccccuccccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcgcggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13031 - RNA, 9873 nt, Artificial Sequence
  derived and/or modified CDS sequence (opt2) from DENV-3__JN368477__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucacccaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccggccaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 13032 - RNA, 9873 nt, Artificial Sequence
  derived and/or modified CDS sequence (opt2) from DENV-3__EF643017__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucuccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucacccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcgucuccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucacccgcgaggaggaggccgagcagaccggcgucucccacaaccucaugaccaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcauguccuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgucggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaccggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13033 - RNA, 9873 nt, Artificial Sequence
  derived and/or modified CDS sequence (opt2) from DENV-3__DQ675519__SS-prME
accuccaucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugccgcauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcgucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccaucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcauccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccaccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgccuaccgcacccgcuccgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccaaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagacccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13034 - RNA, 9873 nt, Artificial Sequence
  derived and/or modified CDS sequence (opt2) from DENV-3__DQ675521__SS-prME
accuccuucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuuccgcgccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13035 - RNA, 9873 nt, Artificial Sequence
  derived and/or modified CDS sequence (opt2) from DENV-3__DQ675522__SS-prME
accuccuucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13036 - RNA, 9873 nt, Artificial Sequence
  derived and/or modified CDS sequence (opt2) from DENV-3__DQ675527__SS-prME
accuccuucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaucaaccagauccucgaggagaacauggacgucgagaucuggaccaaggagggcgagcgcaagaaccuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13037 - RNA, 9873 nt, Artificial Sequence
  derived and/or modified CDS sequence (opt2) from DENV-3__DQ675528__SS-prME
accuccuucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccguccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13038 - RNA, 9873 nt, Artificial Sequence
  derived and/or modified CDS sequence (opt2) from DENV-3__DQ675530__SS-prME
accuccuucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccccacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13039 - RNA, 9873 nt, Artificial Sequence
  derived and/or modified CDS sequence (opt2) from DENV-3__DQ675533__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccacccacgaggcccuccuccccgaguacggcacccucggccucgagugcuccccccgcaccggccucgacuucaacgagaugauccuccucaccaugaagaacaaggccuggaugguccaccgccagugguucuucgaccucccccuccccugggccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacacccucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgaguccugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggagguccuccgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccuccucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgaggucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucguccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucauccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucaccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggagaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 13040 - RNA, 9873 nt, Artificial Sequence
  derived and/or modified CDS sequence (opt2) from DENV-3__AY744677__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagcgccucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13041 - RNA, 9873 nt, Artificial Sequence
  derived and/or modified CDS sequence (opt2) from DENV-3__AY744678__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccuccgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13042 - RNA, 9873 nt, Artificial Sequence
  derived and/or modified CDS sequence (opt2) from DENV-3__AY744679__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggccaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacaucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaugaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucuccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13043 - RNA, 9873 nt, Artificial Sequence
  derived and/or modified CDS sequence (opt2) from DENV-3__AY744680__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13044 - RNA, 9873 nt, Artificial Sequence
  derived and/or modified CDS sequence (opt2) from DENV-3__AY744681__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggccgcaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcuccgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccgccucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13045 - RNA, 9873 nt, Artificial Sequence
  derived and/or modified CDS sequence (opt2) from DENV-3__AY744682__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaccaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucuccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaaccccuaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13046 - RNA, 9873 nt, Artificial Sequence
  derived and/or modified CDS sequence (opt2) from DENV-3__AY744683__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13047 - RNA, 9873 nt, Artificial Sequence
  derived and/or modified CDS sequence (opt2) from DENV-3__AY744684__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuccacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13048 - RNA, 9873 nt, Artificial Sequence
  derived and/or modified CDS sequence (opt2) from DENV-3__AY744685__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagaugcagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacgccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgagaaguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcauccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagaccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacucccacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 13049 - RNA, 9873 nt, Artificial Sequence
  derived and/or modified CDS sequence (opt2) from DENV-3__AY876494__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccccgucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgccgaggccauccuccccgaguacggcacccucguccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuacuacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaccggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccccaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaaccucugggaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccccuggcucgagcccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcuccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13050 - RNA, 9873 nt, Artificial Sequence
  derived and/or modified CDS sequence (opt2) from DENV-3__AY923865__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccggcucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagccccaggucggcaacgacacccagggcgucaccgucgagaucaccccccaggccuccaccgucgaggccguccuccucgaguacggcacccucggccucaagugcuccccccgcaccggccucgacuucaacgagaugauccuccucaccaugaagaccaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuuccucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcaccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 13051 - RNA, 9867 nt, Artificial Sequence
  derived and/or modified CDS sequence (opt2) from DENV-4__KR922405__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugccucggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaccaagaccuggcucguccacaagcagugguuccucgaccucccccuccccuggaccaccggcgccgacacccucgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgucgucuccugguccggcaaggagcucaagugcggcuccggcaucuucgucaucgacaacguccacaccuggaccgagcaguacaaguuccagcccgagucccccgcccgccucgccuccgccauccucaacgcccacaaggagggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucgcccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacaccgagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccauguaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggucaaggccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaaguucgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccguccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcgucaucaugaccaccaccgccaacuggcucuggacccuccucggccgcaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugcgccgcuacuccgcccacuucgaguccgagggcguccucuga

SEQ ID NO: 13052 - RNA, 9867 nt, Artificial Sequence
  derived and/or modified CDS sequence (opt2) from DENV-4__KP188557__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggcccgcaucuucacccccgaggcccgcaacaacaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccgcugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacgcccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13053 - RNA, 9867 nt, Artificial Sequence
  derived and/or modified CDS sequence (opt2) from DENV-4__KP188558__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacgacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaucucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13054 - RNA, 9867 nt, Artificial Sequence
  derived and/or modified CDS sequence (opt2) from DENV-4__KP188563__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggaccgcgaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13055 - RNA, 9867 nt, Artificial Sequence
  derived and/or modified CDS sequence (opt2) from DENV-4__KP188564__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccaucgcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaagaucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccacccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccaacgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13056 - RNA, 9867 nt, Artificial Sequence
  derived and/or modified CDS sequence (opt2) from DENV-4__JN983813__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacaucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13057 - RNA, 9867 nt, Artificial Sequence
  derived and/or modified CDS sequence (opt2) from DENV-4__KF041260__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucauccagaucgagaaccucgaguacaccgucgucgucaccguccacaacggcgacacccacgccgucggcaacgacaccuccaaccacggcgucaccgccaccgucaccccccgcucccccuccgucgaggucgagcuccccgacuacggcgagcucacccucgacugcgagccccgcuccggcaucgacuucaacgagaugauccucaugaagaugaacaagaagaccuggcucguccacaagcagugguuccucgaccucccccuccccuggaccgccggcgccgacaccuccgagguccacuggaaccacaaggagcgcauggucaccuucaaggucccccacgccaagcgccaggacgucaccguccucggcucccaggagggcgccaugcacuccgcccucaccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggcuuccucguccucuggaucggcaccaacucccgcaacaccuccauggccauguccugcaucgccgucggcggcaucacccucuuccucggcuucaccguccacgccgacaugggcugcgccgucuccugguccggcaaggagcucaagugcggcuccggcaucuucaucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucaucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccuucucccagcacaacuaccgccagggcuacgccacccagaccaugggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcaacaccauguccucccgcaugggcggccagacccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucucccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaccguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgaguccggccgccucgagcccuccugggccgacgucaagaacgacaugaucuccuacggcggcggcuggcgccucggcgacaagugggacaaggaggaggacguccagguccucgccgucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaagaccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucguccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucaucaucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacauccacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccgucgcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaugggcaagcucuccaugggccucaucgccaucgccgucgccuccggccuccucugggucgccgagauccagccccaguggaucgccgccuccaucauccucgaguucuuccucauggcccuccucauccccgagcccgagaagcagcgcaccccccaggacaaccagcucaucuacgucauccucaccauccucaccaucaucggccucgucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacacccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucuccggcaacaucgucuccuccgucaacaccaccuccaagaugcuccucaaccgcuucaccacccgcuaccgcaagcccaccuacgagaaggacgccgaccucggcgccggcacccgcuccgucuccaccgagaccgagaagcccgacauggccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuucgaguccgagggcguccucuga

SEQ ID NO: 13058 - RNA, 9867 nt, Artificial Sequence
  derived and/or modified CDS sequence (opt2) from DENV-4__FJ024476__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccgccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaugaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggccuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggcccgcaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccaugggccccuggcaccucggcaagcucgagaucggcuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagcgcgaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucguccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccuccgcgagcgcgucgagaaguggcucaaggagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13059 - RNA, 9867 nt, Artificial Sequence
  derived and/or modified CDS sequence (opt2) from DENV-4__GQ868579__SS-prME
uccaccaucacccuccucugccucauccccaccaucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucaucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccgcgccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccaguccaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggaccgcgaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaccuuccucuucuucaugcagggcaagggcaucggcaagcucuccaugggccucaucaccaucgccauggccuccggccuccucuggaucgccgagauccagccccaguggaucgccgccuccaucauccucgaguucuuccucaugguccuccucauccccgagcccgagaagcagcgcaccccccaggacaaccagcucaucuacgucauccucaccauccucgccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccaggccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaacuggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13060 - RNA, 9867 nt, Artificial Sequence
  derived and/or modified CDS sequence (opt2) from DENV-4__GQ868580__SS-prME
uccaccaucacccuccucugccucauccccaccaucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucaucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucaccgccggccaguccaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccaccuucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccuccucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggaccgcgaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccauggccuccggccuccucuggaucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucuccgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacucccucaacaccuucaccaacauggagguccagcucauccgccagauggaggccgagggcgucaucacccaggacgacaugcagaaccccaagggccucaaggagcgcgucgagaacuggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13061 - RNA, 9867 nt, Artificial Sequence
  derived and/or modified CDS sequence (opt2) from DENV-4__GQ868583__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucaugaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucgccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccuccaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucuccgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13062 - RNA, 9867 nt, Artificial Sequence
  derived and/or modified CDS sequence (opt2) from DENV-4__GQ868584__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccgccaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucaugaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucgccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucuccgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13063 - RNA, 9867 nt, Artificial Sequence
  derived and/or modified CDS sequence (opt2) from DENV-4__GQ868585__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacgagaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucaucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13064 - RNA, 9867 nt, Artificial Sequence
  derived and/or modified CDS sequence (opt2) from DENV-4__JQ922560__SS-prME
uccaccaucacccuccucugccucauccccaccgucauggccuuccaccucuccacccgcgacggcgagccccucaugaucgucgccaagcacgagcgcggccgccgccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcaccggcaagaucaccggcaaccucauccagaucgagaaccucgaguacaccgucgucgucaccguccacaacggcgacacccacgccgucggcaacgacaccuccaaccacggcgucaccgccaccaucaccccccgcucccccuccgucgaggucgagcuccccgacuacggcgagcucacccucgacugcgagccccgcuccggcaucgacuucaacgagaugauccucaugaagaugaacaagaagaccuggcucguccacaagcagugguuccucgaccucccccuccccugggccgccggcgccgacaccuccgagguccacuggaaccacaaggagcgcauggucaccuucaaggucccccacgccaagcgccaggacgucaccguccucggcucccaggagggcgccaugcacuccgcccucaccggcgccaccgaggucuacuccggcgacggcaaccucauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccacccccuucgccgagaacaccaacuccgucaccaacaucgagcucgagccccccuucggcgacuccuacaucgucaucggcgucggcgacuccgcccucacccuccacugguucaccaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggcuuccucguccucuggaucggcaccaacucccgcaacaccuccauggccauguccugcaucgccgucggcggcaucacccucuuccucggcuucaccguccacgccgacaugggcugcgccgucuccugguccggcaaggagcucaagugcggcuccggcaucuucaucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucaucgacggccccgacaccuccgagugccccaacgagcgccgcgccuggaacuuccucgaggucgaggacuacggcuucggcauguucaccaccaacaucuggaugaaguuccgcgagggcuccuccgagaugugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcaacaccauguccucccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucgucgacggcaucucccucggccucauccuccucaagauggucacccacuucgacaacacccaggucggcacccucgcccucucccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaccguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccgucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucguccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucaucaucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccgucgcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucaucgcccuccucggcgccaugaccgccggcaucuuccucuucuucaugcagggcaagggcaugggcaagcucuccaugggccucaucgccaucgccgucgccuccggccuccucugggucgccgagauccagccccaguggaucgccgccuccaucauccucgaguucuuccucauggcccuccucauccccgagcccgagaagcagcgcaccccccaggacaaccagcucaucuacgucauccucaccauccucaccaucaucggccucgucgccgccaacgagaugggccucaucgagaagaccaagaccgacuucggcuucuaccaggagaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacacccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucucccgcaacaucgucuccuccgucaacaccaccuccaagaugcuccucaaccgcuucaccacccgcuaccgcaagcccaccuacgagaaggacgccgaccucggcgccggcacccgcuccgucuccaccgagaccgagaagcccgacauggccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucucccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaucgaggaguacgucgacuacaugcccgucaugaagcgcuacuccgcccccuucgaguccgagggcguccucuga

SEQ ID NO: 13065 - RNA, 9867 nt, Artificial Sequence
  derived and/or modified CDS sequence (opt2) from DENV-4__JQ922558__SS-prME
uccacccucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugccucggcaagaucaccggcaaccucguccagaucgagaaccucgaguacaccgucgucgucaccguccacaacggcgacacccacgccgucggcaacgacaucuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcaguggguccucgaccucccccuccccugggccgccggcgccgacaccuccaagguccaguggaacuacaaggagcgcauggucaccuucaaggucccccacgccaagcgccaggacgucaccguccucggcucccaggagggcgccaugcacuccgcccucaccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagcacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggccuccucguccucuggaucggcaccaacucccgcaacaccuccauggccaugaccugcaucgccaucggcggcaucacccucuuccucggcuucaccguccacgccgacaugggcugcgccgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagcccuggcagaucggcaacgccucccucaucgaggucaagaccugccucuggcccaagacccacacccucugguccaacggcguccucgagucccagaugcucauccccaaggccuacgccggccccuucucccagcacaacuaccgccagggcuacgccacccagaccaucggccccuggcaccucggcaagcucgagaucgacuucggcgagugccccggcaccaccgucaccauccaggaggacugcaaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucaccaucauggccgucuucaagaugucccccggcuacguccucggcgucuuccuccgcaagcucaccucccgcgagaccgcccucaucgucaucggcauggccaugaccaccguccucuccaucccccacgaccucauggaguucaucgacggcaucucccucggccucauccuccucaagauggucgcccacuucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccacugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgaccccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccgccaacccccucuccuccacccgcguccccaacuacaaccucaucgucauggacgaggcccaccuccaggaccucuccaucgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgcccgccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagauccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucauggccaucgccgucgccuccggccuccucugggucgccgagauccagccccaguggaucgccgccuccaucauccucgaguucuucuccauggcccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcucuccguccacuacgccaucaucggccccggccuccaggccaaggccacccgcgaggcccagaagcgcuccgccgccggcaucaugaagaaccccaccgucgacggcaucaccgucaucgaccucgagcccaucuccuacgaccccaaguucgagaagcagcucggccaggucaugcuccucgcccucugcgccggccagcuccuccucaugcgcaccaccugggccuucugcgagguccucacccucgccaccggccccauccucacccucugggagggcaaccccggccgcuucuggaacaccaccauccccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcaucuucgaggucgaccgccacgagaucaaguacacccucaaggacggcuccaagaucaaccacgccauguccaccggcuccaucaagauccgcggcaucgacgagcgcggcauggucaagcccaagggcaaggucgucgaccagggcugcggccgcggcggcuggucccacuacaccgccaccgccaagaaggucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgucgaccucggcgccggcacccgcuccgucuccaucgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgaguucaaggagaaggucuacaccuccaccccccaccccaagcccuggacccgcauggucaugaccaccaccgccaacuggcucugggcccucggcggcaagaagaaguccccccgccucugcaccugggaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccaccgcauccucgccaaggccaucuucaagcucaccuaccacuccaaggucaugaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacguccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccaucgaguccgagggcguccucuga

SEQ ID NO: 13066 - RNA, 9867 nt, Artificial Sequence
  derived and/or modified CDS sequence (opt2) from DENV-4__JQ922559__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaucuccauccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccaguggaacuacaaggagcgcauggucaccuucaaggucccccacgccaagcgccaggacgucaccguccucggcucccaggagggcgccaugcacuccgcccucaccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccuacuccgucaccaacaucgagcucgagccccccuucggcgacuccuacaucaucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgccgucuccugguccggcaaggagcucaagugcggcuccggcaucuucgucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccaucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucaucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagcgcgaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccucccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccagaugggcacccucgcccucucccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccguccucuccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgucaugggcgccaacuuccgcgccggccgcgucaucgacccccgccgcugccucaagcccgucaucaucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcgagcucuccaugggccucaucgccaucgccggcgccuccggccuccucuggggcaccaagacccccccccccuggggcgccgccuccaacauccucgaguucuuccucaugguccuccucauccccgagcccgagaagcagcgcaccccccaggacaaccagcucaucuacgucauccucaccauccucaccaucaucggccucgucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaucgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcgucaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcaggccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacucccgcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucuccggcaacaucgucuccuccgucaacaccaccuccaagaugcuccucaaccgcuucaccaccaagcaccgcaagcccaccuacgagaaggacgccgaccucggcgccggcacccgcuccgucuccaccgagaccgagaagcccgacaugaccaucaucggccgccgccuccagcgccuccaggaggagcaccaggagaccuggcacuacgaccaggagaaccccuaccgcaccugggccuaccacggcggcuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucucccaggaggagcagggcuggaccuccuccuucgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggaccucgacaagcgcgaccgcucccucgucuucgccgacgacaccgccggcugggacaccaagauccccgaggacgaccuccucaaggagaagcccauccccggccccauggccccccaccagcgcauccccgcccgcgccaucuucaagcucaccuaccagaacaaggucgucaagguccuccgccucaagcucaagggcgccgucauggacaucaucucccgcaaggagcagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucgagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaucgagggcuacgucgacuacuuccuccucaucaagugguacuccgcccccuucgaguccgagggcguccucuga

SEQ ID NO: 13067 - RNA, 9867 nt, Artificial Sequence
  derived and/or modified CDS sequence (opt2) from DENV-4__KF955510__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcaccgagaccuggauguccuccgagggcgccuggaagcacgcccagcgcgucgaguccuggauccuccgcaagcccggcuucgcccucuccgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgagaccgccaccaucaccccccgcucccccuccgucgagguccgccuccccgacuacggcgagcucacccucgacugcgagccccgcuccggcaucgacuucaacgagaugauccucaugaagaugaagaccaagaccuggcucguccacaagcagugguuccucgaccucccccuccccuggaccgccggcgccgacaccuccgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgccggcgacuccgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgucgucggcggcaucacccucuuccucggcuucaccguccacgccgacaugggcugcgucgucuccugguccggcaaggagcucaagugcggcuccggcaucuucgucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccauguucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucucccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgccuaccgcaucaugcagcgcggccucuucggcaagacccaggucggcgucggcauccacauggagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaugggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggccaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaagggcuucgaggaguacaagcgcuccggcauccucgaggucgaccgcaccgaggccaaguccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcgucgucaugaccaccaccgccaacuggcucugggcccuccucggccgcaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccacuucgaguccgagggcguccucuga

SEQ ID NO: 13068 - RNA, 9867 nt, Artificial Sequence
  derived and/or modified CDS sequence (opt2) from DENV-4__GQ868594__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacgagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacauccccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccugggccgccggcgccgacaccuccgagguccacuggaacuacaaggagcgcauggucaccuucaaggucccccacgccaagcgccaggacgucaucguccucggcucccaggagggcgccaugcacuccgcccucaccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgaguacaccaacuccgucaccaacaucgagcucgagccccccuucggcgacuccuacaucgucaucggcgucggcgacuccgcccucacccuccacugguuccgcaagggcuccuccaucggcaagaugcucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggcuuccucguccucuggaucggcaccaacucccgcaacaccuccauggccaugaccugcaucgccgucggcggcaucacccucuuccucggcuucaccguccacgccgacaccggcugcgccgucuccugguccggcaaggagcucaagugcggcuccggcaucuucgucaucgacaacguccacaccuggaccgagcaguacaaguuccagcccgagucccccgcccgccucgccuccgccauccucaacgcccacaaggacggcgucugcggcauccgcuccaccacccgccucgagaacaucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgaggccaagaacuccaccuuccucaucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacaucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaccggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucaucuccaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagaaccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaucgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccguccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuucgaguccgagggcguccucuga

SEQ ID NO: 13069 - RNA, 9867 nt, Artificial Sequence
  derived and/or modified CDS sequence (opt2) from DENV-4__FJ024424__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccaccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccacccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacaugauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13070 - RNA, 9867 nt, Artificial Sequence
  derived and/or modified CDS sequence (opt2) from DENV-4__EU854295__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccccggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcgucgucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13071 - RNA, 9867 nt, Artificial Sequence
  derived and/or modified CDS sequence (opt2) from DENV-4__EU854296__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgccaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggccaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaucggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuaccgccccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13072 - RNA, 9867 nt, Artificial Sequence
  derived and/or modified CDS sequence (opt2) from DENV-4__GQ199878__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13073 - RNA, 9867 nt, Artificial Sequence
  derived and/or modified CDS sequence (opt2) from DENV-4__GQ199879__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaccaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13074 - RNA, 9867 nt, Artificial Sequence
  derived and/or modified CDS sequence (opt2) from DENV-4__GQ199880__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaccaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13075 - RNA, 9867 nt, Artificial Sequence
  derived and/or modified CDS sequence (opt2) from DENV-4__GQ252675__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagauccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucaccgccggccagggcaccuccgagaccuucuccaugggccuccucugccucacccucuucgucgaggagugccuccgccgccgcgucacccgcaagcacaugaugcucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaccgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaccaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13076 - RNA, 9867 nt, Artificial Sequence
  derived and/or modified CDS sequence (opt2) from DENV-4__FJ810417__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaucccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaccaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13077 - RNA, 9867 nt, Artificial Sequence
  derived and/or modified CDS sequence (opt2) from DENV-4__FJ850057__SS-prME
uccaccaucacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccacccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaccaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13078 - RNA, 9867 nt, Artificial Sequence
  derived and/or modified CDS sequence (opt2) from DENV-4__GQ199881__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagacccgcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuucaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaugauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcuccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucgccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13079 - RNA, 9867 nt, Artificial Sequence
  derived and/or modified CDS sequence (opt2) from DENV-4__GQ199882__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggcuccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13080 - RNA, 9867 nt, Artificial Sequence
  derived and/or modified CDS sequence (opt2) from DENV-4__GQ199883__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgccgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucgccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13081 - RNA, 9867 nt, Artificial Sequence
  derived and/or modified CDS sequence (opt2) from DENV-4__GQ199884__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucgccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13082 - RNA, 9867 nt, Artificial Sequence
  derived and/or modified CDS sequence (opt2) from DENV-4__FJ882595__SS-prME
uccaccaucacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaccggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13083 - RNA, 9867 nt, Artificial Sequence
  derived and/or modified CDS sequence (opt2) from DENV-4__FJ882596__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacguccgcggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13084 - RNA, 9867 nt, Artificial Sequence
  derived and/or modified CDS sequence (opt2) from DENV-4__FJ850059__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgucugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaucgcccacaaggacggcgucugcggcauccgcuccaccacccgccucgagaacgucauguggaagcagaucaccaacgagcucaacuacguccucugggagggcggccacgaccucaccgucgucgccggcgacgccaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuaccgccccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13085 - RNA, 9867 nt, Artificial Sequence
  derived and/or modified CDS sequence (opt2) from DENV-4__FJ882598__SS-prME
uccaccaucacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13086 - RNA, 9867 nt, Artificial Sequence
  derived and/or modified CDS sequence (opt2) from DENV-4__FJ882601__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucgucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucgccauccucaccaucaucggccucaucgccgccaacgagaugggccucaucgagaagaccaagaccgacuucggcuucuaccaggagaagaccgagaccaccauccucgacgucgaccuccgccccgccuccgccuggacccucuacgccgucgccaccaccauccucacccccaugcuccgccacaccaucgagaacaccuccgccaaccucucccucaccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccucaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacguccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucgucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13087 - RNA, 9867 nt, Artificial Sequence
  derived and/or modified CDS sequence (opt2) from DENV-4__FJ226067__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgccgcggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucaccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacgcccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccucuccgaguccgagggcguccucuga

SEQ ID NO: 13088 - RNA, 9867 nt, Artificial Sequence
  derived and/or modified CDS sequence (opt2) from DENV-4__EU854299__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13089 - RNA, 9867 nt, Artificial Sequence
  derived and/or modified CDS sequence (opt2) from DENV-4__FJ182016__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgagguccgcggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccaccgcaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13090 - RNA, 9867 nt, Artificial Sequence
  derived and/or modified CDS sequence (opt2) from DENV-4__EU854300__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgagacccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacaucgagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccucgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaaggccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13091 - RNA, 9867 nt, Artificial Sequence
  derived and/or modified CDS sequence (opt2) from DENV-4__FJ182017__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucgcccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13092 - RNA, 9867 nt, Artificial Sequence
  derived and/or modified CDS sequence (opt2) from DENV-4__EU854301__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccagaucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaugggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcucuuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuccgaguccgagggcguccucuga

SEQ ID NO: 13093 - RNA, 9867 nt, Artificial Sequence
  derived and/or modified CDS sequence (opt2) from DENV-4__FJ639736__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13094 - RNA, 9867 nt, Artificial Sequence
  derived and/or modified CDS sequence (opt2) from DENV-4__FJ639737__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucaucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacgacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccuccguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacaucgagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaucgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13095 - RNA, 9867 nt, Artificial Sequence
  derived and/or modified CDS sequence (opt2) from DENV-4__FJ639738__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgccgccucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccgucgagcccggcaagaaccccaagcacguccagaccaagcccggccucuucaagaccaucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13096 - RNA, 9867 nt, Artificial Sequence
  derived and/or modified CDS sequence (opt2) from DENV-4__FJ639739__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucgccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaagaucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgaguggcuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13097 - RNA, 9867 nt, Artificial Sequence
  derived and/or modified CDS sequence (opt2) from DENV-4__JN819409__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccgccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacggcgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucaucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcaccaaggaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13098 - RNA, 9867 nt, Artificial Sequence
  derived and/or modified CDS sequence (opt2) from DENV-4__FJ639742__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacauggucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccuccguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13099 - RNA, 9867 nt, Artificial Sequence
  derived and/or modified CDS sequence (opt2) from DENV-4__FJ639745__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggccuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucgccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13100 - RNA, 9867 nt, Artificial Sequence
  derived and/or modified CDS sequence (opt2) from DENV-4__FJ850095__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13101 - RNA, 9867 nt, Artificial Sequence
  derived and/or modified CDS sequence (opt2) from DENV-4__FJ639748__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgagguccagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggccuccucguccucuggaucggcaccaacucccgcaacaccuccauggccaugaccugcaucgccgucggcggcaucacccucuuccucggcuucaccguccaggccgacgucggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccaguccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucgccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgagaacgagggcguccucuga

SEQ ID NO: 13102 - RNA, 9867 nt, Artificial Sequence
  derived and/or modified CDS sequence (opt2) from DENV-4__FJ639764__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaccaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaucgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcacccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgccgccucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccgucgagcccggcaagaaccccaagcacguccagaccaagcccggccucuucaagaccaucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13103 - RNA, 9867 nt, Artificial Sequence
  derived and/or modified CDS sequence (opt2) from DENV-4__FJ639773__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagcgccuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccaccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggagaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13104 - RNA, 9867 nt, Artificial Sequence
  derived and/or modified CDS sequence (opt2) from DENV-4__FJ882580__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagcgcgucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccaucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13105 - RNA, 9867 nt, Artificial Sequence
  derived and/or modified CDS sequence (opt2) from DENV-4__FJ882581__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccucgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13106 - RNA, 9867 nt, Artificial Sequence
  derived and/or modified CDS sequence (opt2) from DENV-4__FJ882582__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccucgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgccgacuacaugcccgucaugaagcgcuacuccgcccccuccgaguccgagggcguccucuga

SEQ ID NO: 13107 - RNA, 9867 nt, Artificial Sequence
  derived and/or modified CDS sequence (opt2) from DENV-4__FJ882584__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13108 - RNA, 9867 nt, Artificial Sequence
  derived and/or modified CDS sequence (opt2) from DENV-4__FJ882585__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaccauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgccaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcaccaaggaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13109 - RNA, 9867 nt, Artificial Sequence
  derived and/or modified CDS sequence (opt2) from DENV-4__FJ882586__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucgcccagguccgcaaccucaucggcaaggaggaguacgucgacuacaugcccgucaugaagcgcuacuccgcccccuccgaguccgagggcguccucuga

SEQ ID NO: 13110 - RNA, 9867 nt, Artificial Sequence
  derived and/or modified CDS sequence (opt2) from DENV-4__JN819406__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccgcccgcgagcucaagugcggcuccggcaucuucgucgucgacaacguccacaccuggaccgagcaguaccaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13111 - RNA, 9867 nt, Artificial Sequence
  derived and/or modified CDS sequence (opt2) from DENV-4__GQ199876__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucaucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccguccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13112 - RNA, 9867 nt, Artificial Sequence
  derived and/or modified CDS sequence (opt2) from DENV-4__KP723482__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcaacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucaccuucugcgccaucauccucggcggccucaccuggauggaccuccuccgcguccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccuccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagcccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcaccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccgucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13113 - RNA, 9867 nt, Artificial Sequence
  derived and/or modified CDS sequence (opt2) from DENV-4__JN638570__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugccucggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaccaagaccuggcucguccacaagcagugguuccucgaccucccccuccccuggaccaccggcgccgacacccucgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacggcgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgucgucuccugguccggcaaggagcucaagugcggcuccggcaucuucgucaucgacaacguccacaccuggaccgagcaguacaaguuccagcccgagucccccgcccgccucgccuccgccauccucaacgcccacaaggagggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcucccccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgccggccccuggcaccucggcaagcucgagaucgacuucggcgagugccccggcaccaccgucaccguccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccagggcaccuccgagaccuucuccaugggccuccucugccucacccucuucgucgaggagugccuccgccgccgcgucacccgcaagcacaugaugcucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucgccaucccccacgaccucauggaguucaucgacggcaucucccucggccucauccuccucaagauggucacccacuucgacaacacccaggucggcacccucgcccucgcccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccgcugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacaccgagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggucaaggccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgcuacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagcgcgacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcgucgucaugaccaccaccgccaacuggcucuggacccuccucggccgcaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugcgccgcuacuccgcccacuucgaguccgagggcguccucuga

SEQ ID NO: 13114 - RNA, 9867 nt, Artificial Sequence
  derived and/or modified CDS sequence (opt2) from DENV-4__JN638571__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugccucggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgaguacggcgagcucacccucgacugcgagccccgcuccggcaucgacuucaacgagaugauccucaugaagaugaagaccaagaccuggcucguccacaagcagugguuccucgaccucccccuccccuggaccaccggcgccgacacccucgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacggcgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgucgucuccugguccggcaaggagcucaagugcggcuccggcaucuucgucaucgacaacguccacaccuggaccgagcaguacaaguuccagcccgagucccccgcccgccucgccuccgccauccucaacgcccacaaggagggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgccggccccuggcaccucggcaagcucgagaucgacuucggcgagugccccggcaccaccgucaccguccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccagggcaccuccgagaccuucuccaugggccuccucugccucacccucuucgucgaggagugccuccgccgccgcgucacccgcaagcacaugaugcucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucgccaucccccacgaccucauggaguucaucgacggcaucucccucggccucauccuccucaagauggucacccacuucgacaacacccaggucggcacccucgcccucgcccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccgcugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacaccgagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggucaaggccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgcuacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagcgcgacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcgucgucaugaccaccaccgccaacuggcucuggacccuccucggccgcaagaagaacccccgccucugcacccgcgaggaguucaucuccaagguccgccucaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugcgccgcuacuccgcccacuucgaguccgagggcguccucuga

SEQ ID NO: 13115 - RNA, 9867 nt, Artificial Sequence
  derived and/or modified CDS sequence (opt2) from DENV-4__JN638572__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugccucggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgaguacggcgagcucacccucgacugcgagccccgcuccggcaucgacuucaacgagaugauccucaugaagaugaagaccaagaccuggcucguccacaagcagugguuccucgaccucccccuccccuggaccaccggcgccgacacccucgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacggcgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgucgucuccugguccggcaaggagcucaagugcggcuccggcgucuucgucaucgacaacguccacaccuggaccgagcaguacaaguuccagcccgagucccccgcccgccucgccuccgccauccucaacgcccacaaggagggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgccggccccuggcaccucggcaagcucgagaucgacuucggcgagugccccggcaccaccgucaccguccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucgccaucccccacgaccucauggaguucaucgacggcaucucccucggccucauccuccucaagauggucacccacuucgacaacacccaggucggcacccucgcccucgcccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccgcugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacaccgagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggucaaggccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaccaagcacgccgucucccgcggcuccuccaagauccgcuggaucgucgagcgcggcaugaucaagcccaagggcaaggucgucgaccucggcugcggccgcggcggcugguccuacuacauggccacccuccagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgcuacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagcgcgacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcgucgucaugaccaccaccgccaacuggcucuggacccuccucggccgcaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagguccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacauggacuacaugcccgucaugaagcgcuacuccgcccccuccgaguccgagggcguccucuga

SEQ ID NO: 13116 - RNA, 9867 nt, Artificial Sequence
  derived and/or modified CDS sequence (opt2) from DENV-4__JX024757__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccugguccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacggccgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaaguacaugaugcucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccuccgcaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgcccucaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaugaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaacccccgcggccucaaggagcgcgucgagaaguggcucaaggagugcggcgucgaccgccucaagcgcauggccaucuccggcgacgacugcgucgucaagcccaucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13117 - RNA, 9867 nt, Artificial Sequence
  derived and/or modified CDS sequence (opt2) from DENV-4__JF741967__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcaacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucaccuucugcgccaucauccucggcggccucaccuggauggaccuccuccgcguccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgaggucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccgccgccacccacaaggccacccucuccgagggcgucuaccgcaucaugcagcgcggccucuucggcaagacccaggucggcgucggcauccacauggagggcgucuuccacaccgucggccacgucacccgcggcuccgucaucugccacgagaccggccgccucgagcccuccuggggcgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagcccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcaccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccgucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13118 - RNA, 9867 nt, Artificial Sequence
  derived and/or modified CDS sequence (opt2) from DENV-4__JQ822247__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcaacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucaccuucugcgccaucauccucggcggccucaccuggauggaccuccuccgcguccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagcccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcaccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccgucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13119 - RNA, 9867 nt, Artificial Sequence
  derived and/or modified CDS sequence (opt2) from DENV-4__JF262783__SS-prME
uccaccgucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucauguacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucacccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgucgucggcaaggacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccaguggaacuacaaggagcgcauggucaccuucaaggucccccacgccaagcgccaggacgucaccguccucggcucccaggagggcgccaugcacuccgcccucaccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggccuccucguccucuggaucggcaccaacucccgcaacaccuccauggccaugaccugcaucgccaucggcggcaucacccucuuccucggcuucaccguccacgccgacaugggcugcgccgucuccugguccggcaaggagcucaagugcggcuccggcaucuucgucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuuccucgaggucgaggacuacggcuucggcauguucgccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacgagguccucgagucccagaugcucauccccaaggccuacgccggccccuucucccagcacaacuaccgccagggcuacgccacccagaccaucggccccuggcaccucggcaagcucgagaucgacuucggcgagugccccggcaccaccgucaccauccaggaggacugcaaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucaccaucauggccgucuucaagaugucccccggcuacguccucggcgucuuccuccgcaagcucaccucccgcgagaccgcccucaucgucaucggcauggccaugaccaccguccucuccaucccccacgaccucauggaguucaucgacggcaucucccucggccucauccuccucaagauggucgcccacuucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggccgcgucaucggccucuacggcaacggcaucgucaccaaguccggcgacuacgucuccgccaucacccaggccgagcgcaucggcgagcccgacuacgaggucgacgaggacaucuuccgcaagaagcgccucaccgucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgcccgccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagauccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucauggccaucgccgucgccuccggccuccucugggucgccgagauccagccccaguggaucgccgccuccaucauccucgaguucuuccucauggcccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcucuccguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucgcccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucaaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccaccgcauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuucgaguccgagggcguccucuga
